United States Patent 11,931,406 (FLAVIVIRUS VACCINE) - sequence listing, part 44

SEQ ID NO: 16449 - RNA, 9879 nt, Artificial Sequence
  derived and/or modified CDS sequence (opt4) from DENV-1__FJ882568__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccgugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16450 - RNA, 9879 nt, Artificial Sequence
  derived and/or modified CDS sequence (opt4) from DENV-1__FJ882569__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16451 - RNA, 9879 nt, Artificial Sequence
  derived and/or modified CDS sequence (opt4) from DENV-1__GQ199833__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16452 - RNA, 9879 nt, Artificial Sequence
  derived and/or modified CDS sequence (opt4) from DENV-1__FJ882570__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacaucuucguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgcccuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16453 - RNA, 9879 nt, Artificial Sequence
  derived and/or modified CDS sequence (opt4) from DENV-1__GQ199834__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggacggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16454 - RNA, 9879 nt, Artificial Sequence
  derived and/or modified CDS sequence (opt4) from DENV-1__GQ199835__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccugacccugauggccaccuucaagaugagacccauguucgccgugggccugcugcugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16455 - RNA, 9879 nt, Artificial Sequence
  derived and/or modified CDS sequence (opt4) from DENV-1__FJ898386__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgccuucugguga

SEQ ID NO: 16456 - RNA, 9879 nt, Artificial Sequence
  derived and/or modified CDS sequence (opt4) from DENV-1__FJ898387__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16457 - RNA, 9879 nt, Artificial Sequence
  derived and/or modified CDS sequence (opt4) from DENV-1__FJ898389__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccuguuccugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagcuucggcugcaagccccuggccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccuucagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16458 - RNA, 9879 nt, Artificial Sequence
  derived and/or modified CDS sequence (opt4) from DENV-1__FJ898390__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16459 - RNA, 9879 nt, Artificial Sequence
  derived and/or modified CDS sequence (opt4) from DENV-1__FJ898391__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16460 - RNA, 9879 nt, Artificial Sequence
  derived and/or modified CDS sequence (opt4) from DENV-1__FJ898392__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16461 - RNA, 9879 nt, Artificial Sequence
  derived and/or modified CDS sequence (opt4) from DENV-1__FJ898393__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16462 - RNA, 9879 nt, Artificial Sequence
  derived and/or modified CDS sequence (opt4) from DENV-1__FJ898394__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccccccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16463 - RNA, 9879 nt, Artificial Sequence
  derived and/or modified CDS sequence (opt4) from DENV-1__GQ199838__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16464 - RNA, 9879 nt, Artificial Sequence
  derived and/or modified CDS sequence (opt4) from DENV-1__FJ898396__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucacccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16465 - RNA, 9879 nt, Artificial Sequence
  derived and/or modified CDS sequence (opt4) from DENV-1__GQ199839__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagcagaaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggccugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacaucuucguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgcccuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16466 - RNA, 9879 nt, Artificial Sequence
  derived and/or modified CDS sequence (opt4) from DENV-1__FJ898397__SS-prME
agcgugaccaugcugcugaugcugaugcccaccgcccuggccuuccaccugaccaucagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16467 - RNA, 9879 nt, Artificial Sequence
  derived and/or modified CDS sequence (opt4) from DENV-1__FJ898398__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagagcauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcugaacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16468 - RNA, 9879 nt, Artificial Sequence
  derived and/or modified CDS sequence (opt4) from DENV-1__FJ898399__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16469 - RNA, 9879 nt, Artificial Sequence
  derived and/or modified CDS sequence (opt4) from DENV-1__FJ898401__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacggccacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagaaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccacggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16470 - RNA, 9879 nt, Artificial Sequence
  derived and/or modified CDS sequence (opt4) from DENV-1__FJ898402__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggaccgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16471 - RNA, 9879 nt, Artificial Sequence
  derived and/or modified CDS sequence (opt4) from DENV-1__FJ898403__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16472 - RNA, 9879 nt, Artificial Sequence
  derived and/or modified CDS sequence (opt4) from DENV-1__FJ898404__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16473 - RNA, 9879 nt, Artificial Sequence
  derived and/or modified CDS sequence (opt4) from DENV-1__GQ199840__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaccggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacauccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16474 - RNA, 9879 nt, Artificial Sequence
  derived and/or modified CDS sequence (opt4) from DENV-1__FJ898405__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcaacaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16475 - RNA, 9879 nt, Artificial Sequence
  derived and/or modified CDS sequence (opt4) from DENV-1__FJ898406__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcaacaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacauggccagcaugaagagauucaagaacgagggcgaccccgagggcgcccugugguga

SEQ ID NO: 16476 - RNA, 9879 nt, Artificial Sequence
  derived and/or modified CDS sequence (opt4) from DENV-1__GQ199841__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16477 - RNA, 9879 nt, Artificial Sequence
  derived and/or modified CDS sequence (opt4) from DENV-1__FJ898407__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16478 - RNA, 9879 nt, Artificial Sequence
  derived and/or modified CDS sequence (opt4) from DENV-1__FJ898408__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgaccccggcgacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16479 - RNA, 9879 nt, Artificial Sequence
  derived and/or modified CDS sequence (opt4) from DENV-1__GQ199843__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16480 - RNA, 9879 nt, Artificial Sequence
  derived and/or modified CDS sequence (opt4) from DENV-1__GQ199844__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16481 - RNA, 9879 nt, Artificial Sequence
  derived and/or modified CDS sequence (opt4) from DENV-1__GQ199845__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcauguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaccaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16482 - RNA, 9879 nt, Artificial Sequence
  derived and/or modified CDS sequence (opt4) from DENV-1__GQ199846__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaucauggccagagacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16483 - RNA, 9879 nt, Artificial Sequence
  derived and/or modified CDS sequence (opt4) from DENV-1__GQ199847__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgaccccgacgacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16484 - RNA, 9879 nt, Artificial Sequence
  derived and/or modified CDS sequence (opt4) from DENV-1__GQ199849__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagcagaaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcuggcccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggccugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagagaaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacaucuucguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgcccuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16485 - RNA, 9879 nt, Artificial Sequence
  derived and/or modified CDS sequence (opt4) from DENV-1__FJ898410__SS-prME
agcgugaccaugcugcugaugcugacccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16486 - RNA, 9879 nt, Artificial Sequence
  derived and/or modified CDS sequence (opt4) from DENV-1__FJ898411__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16487 - RNA, 9879 nt, Artificial Sequence
  derived and/or modified CDS sequence (opt4) from DENV-1__FJ898412__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgugaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16488 - RNA, 9879 nt, Artificial Sequence
  derived and/or modified CDS sequence (opt4) from DENV-1__GQ199852__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaccaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugccccugcacugcgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16489 - RNA, 9879 nt, Artificial Sequence
  derived and/or modified CDS sequence (opt4) from DENV-1__FJ898415__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcaacaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaccauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16490 - RNA, 9879 nt, Artificial Sequence
  derived and/or modified CDS sequence (opt4) from DENV-1__FJ898416__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgugcugugguga

SEQ ID NO: 16491 - RNA, 9879 nt, Artificial Sequence
  derived and/or modified CDS sequence (opt4) from DENV-1__FJ898417__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgaccccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16492 - RNA, 9879 nt, Artificial Sequence
  derived and/or modified CDS sequence (opt4) from DENV-1__GQ868612__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagccugaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16493 - RNA, 9879 nt, Artificial Sequence
  derived and/or modified CDS sequence (opt4) from DENV-1__FJ898419__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcuggacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16494 - RNA, 9879 nt, Artificial Sequence
  derived and/or modified CDS sequence (opt4) from DENV-1__FJ898420__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcagacuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacaagagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16495 - RNA, 9879 nt, Artificial Sequence
  derived and/or modified CDS sequence (opt4) from DENV-1__FJ898421__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugagcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcggccccgagggcgcccugugguga

SEQ ID NO: 16496 - RNA, 9879 nt, Artificial Sequence
  derived and/or modified CDS sequence (opt4) from DENV-1__FJ898423__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucauccaguacgagaaccugaaguacagcgugaucgugaccgugcacaccggcgaccagcaccaggugggcaacgagagcaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccaccggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagauggugagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcacaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16497 - RNA, 9879 nt, Artificial Sequence
  derived and/or modified CDS sequence (opt4) from DENV-1__FJ898424__SS-prME
agcgugaccaugcugcugaugcugaugcccaccgcccuggccuuccaccugaccaccagaggcggcgagccccacaugaucgugagcaagcaggagagaggcaagagccugcuguucaagaccagcaccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16498 - RNA, 9879 nt, Artificial Sequence
  derived and/or modified CDS sequence (opt4) from DENV-1__FJ898425__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16499 - RNA, 9879 nt, Artificial Sequence
  derived and/or modified CDS sequence (opt4) from DENV-1__FJ898426__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgagguggccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16500 - RNA, 9879 nt, Artificial Sequence
  derived and/or modified CDS sequence (opt4) from DENV-1__GQ199856__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugguggccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaacuucgugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagcugaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16501 - RNA, 9879 nt, Artificial Sequence
  derived and/or modified CDS sequence (opt4) from DENV-1__FJ898427__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacugcgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16502 - RNA, 9879 nt, Artificial Sequence
  derived and/or modified CDS sequence (opt4) from DENV-1__JF937599__SS-prME
agcgugaccaugcugcugaugcugaugcccaccgcccuggccuuccaccugaccgccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgaggugcagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16503 - RNA, 9879 nt, Artificial Sequence
  derived and/or modified CDS sequence (opt4) from DENV-1__FJ898431__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugcuguuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16504 - RNA, 9879 nt, Artificial Sequence
  derived and/or modified CDS sequence (opt4) from DENV-1__GU131678__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcaugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucaaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuuccugcugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgccggcgagagaaacaaccaggugcuggaggagaacauggacguggagaucuggaccaaggagggcgagagaaagaagcugcugcccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggaugggcagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggccaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggccccgccaagcugagaugguucguggagagaacccuggugaaccccgagggcaaggugaucgcccugggcugcggcagaggcgccuggagcuacuacugcgccggccugaagaagggcaccgaggugaagggcuacaccaagggcggccccggccacgaggagcccauccccauggccaccuacggcugggaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggaccccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugccccaccugcguguacaacaugaugggcaagagagagaagaagcugggcgaguucggcaaggccaagggcagcagacccaucugguacauguggcugggcgccagauuccuggaguucgaggcccugggcuucaugaacgaggaccacugguucagcagagagaacagccugagcggcguggagggcgaggcccugcacaagcugggcuacauccugagagacaucagcaagauccccggcggcaacauguacgccgacgacaccgccggcugggacaccagaaucaccgaggacgaccugcagaacgagggcaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggacccugagagagaccgccugccugggcaagagcuacgcccagauguggcagcugauguacuuccccagaagagcccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugacccccagagccaccuggcccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16505 - RNA, 9879 nt, Artificial Sequence
  derived and/or modified CDS sequence (opt4) from DENV-1__GU131679__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacaugcugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgagcuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16506 - RNA, 9879 nt, Artificial Sequence
  derived and/or modified CDS sequence (opt4) from DENV-1__GU131680__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16507 - RNA, 9879 nt, Artificial Sequence
  derived and/or modified CDS sequence (opt4) from DENV-1__GU131681__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaaggugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16508 - RNA, 9879 nt, Artificial Sequence
  derived and/or modified CDS sequence (opt4) from DENV-1__GU131682__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16509 - RNA, 9879 nt, Artificial Sequence
  derived and/or modified CDS sequence (opt4) from DENV-1__GU131683__SS-prME
agcgugaccaugcugcugaugcugaugcccaccgcccuggccuuccaccugaccaccagaggcggcgagccccacaugaucgugagcaagcaggagagaggcaagagccugcuguucaagacccccgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggcccacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccuucuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16510 - RNA, 9879 nt, Artificial Sequence
  derived and/or modified CDS sequence (opt4) from DENV-1__GU131684__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcaaggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16511 - RNA, 9879 nt, Artificial Sequence
  derived and/or modified CDS sequence (opt4) from DENV-1__GU131685__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggagaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16512 - RNA, 9879 nt, Artificial Sequence
  derived and/or modified CDS sequence (opt4) from DENV-1__GQ868614__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccccuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16513 - RNA, 9879 nt, Artificial Sequence
  derived and/or modified CDS sequence (opt4) from DENV-1__GU131688__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16514 - RNA, 9879 nt, Artificial Sequence
  derived and/or modified CDS sequence (opt4) from DENV-1__GU131689__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaugaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16515 - RNA, 9879 nt, Artificial Sequence
  derived and/or modified CDS sequence (opt4) from DENV-1__GU131690__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16516 - RNA, 9879 nt, Artificial Sequence
  derived and/or modified CDS sequence (opt4) from DENV-1__GU131695__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaaccugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16517 - RNA, 9879 nt, Artificial Sequence
  derived and/or modified CDS sequence (opt4) from DENV-1__GU131697__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccaguaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacaagcaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16518 - RNA, 9879 nt, Artificial Sequence
  derived and/or modified CDS sequence (opt4) from DENV-1__GU131700__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcugaccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagaccaugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16519 - RNA, 9879 nt, Artificial Sequence
  derived and/or modified CDS sequence (opt4) from DENV-1__GU131701__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaccgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacgccuucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacagacugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccggcaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16520 - RNA, 9879 nt, Artificial Sequence
  derived and/or modified CDS sequence (opt4) from DENV-1__GU131703__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16521 - RNA, 9879 nt, Artificial Sequence
  derived and/or modified CDS sequence (opt4) from DENV-1__GU131706__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucagaaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16522 - RNA, 9879 nt, Artificial Sequence
  derived and/or modified CDS sequence (opt4) from DENV-1__GU131708__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccagcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaugggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16523 - RNA, 9879 nt, Artificial Sequence
  derived and/or modified CDS sequence (opt4) from DENV-1__GU131710__SS-prME
agcgugaccaugcugcugaugcugaugcccaccgcccuggccuuccaccugaccaccagaggcggcgagccccacaugaucgccagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagagaaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16524 - RNA, 9879 nt, Artificial Sequence
  derived and/or modified CDS sequence (opt4) from DENV-1__GU131717__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugaugcaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16525 - RNA, 9879 nt, Artificial Sequence
  derived and/or modified CDS sequence (opt4) from DENV-1__GU131718__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaucgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaucgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16526 - RNA, 9879 nt, Artificial Sequence
  derived and/or modified CDS sequence (opt4) from DENV-1__GU131720__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucgccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucaugaagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16527 - RNA, 9879 nt, Artificial Sequence
  derived and/or modified CDS sequence (opt4) from DENV-1__HM181960__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcagagugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16528 - RNA, 9879 nt, Artificial Sequence
  derived and/or modified CDS sequence (opt4) from DENV-1__HM181963__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaucggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagguggugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16529 - RNA, 9879 nt, Artificial Sequence
  derived and/or modified CDS sequence (opt4) from DENV-1__HM181964__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccugagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16530 - RNA, 9879 nt, Artificial Sequence
  derived and/or modified CDS sequence (opt4) from DENV-1__HM181966__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccuggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaucgccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcuggugaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16531 - RNA, 9879 nt, Artificial Sequence
  derived and/or modified CDS sequence (opt4) from DENV-1__GU131721__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucgugcccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgagcccgagggcgcccugugguga

SEQ ID NO: 16532 - RNA, 9879 nt, Artificial Sequence
  derived and/or modified CDS sequence (opt4) from DENV-1__GU131723__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16533 - RNA, 9879 nt, Artificial Sequence
  derived and/or modified CDS sequence (opt4) from DENV-1__GU131725__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucagcgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagggcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcagaggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16534 - RNA, 9879 nt, Artificial Sequence
  derived and/or modified CDS sequence (opt4) from DENV-1__GU131726__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucgccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcugcugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagccccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16535 - RNA, 9879 nt, Artificial Sequence
  derived and/or modified CDS sequence (opt4) from DENV-1__GU131727__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguaccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16536 - RNA, 9879 nt, Artificial Sequence
  derived and/or modified CDS sequence (opt4) from DENV-1__HM631850__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagccccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16537 - RNA, 9879 nt, Artificial Sequence
  derived and/or modified CDS sequence (opt4) from DENV-1__KF955446__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggccgagguguucagaaagagaaaccugaccaucauggaccugcaccccggcagcggcaagaccagaagauaccugcccgccaucgugagagaggccaucaagagaaagcugagaacccugauccuggcccccaccagagugggcgccagcgagauggccgaggcccugaagggcaugcccaucagauaccagaccaccgccgugaagagcgagcacaccggcaaggagaucguggaccugaugggccacgccaccuucaccaugggccugcuggcccccggcagagugcccaacuacaacauggugaucauggacgaggcccacuucaccgaccccagcagaaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaaccccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccccuggaccgaggccaagaugcugcuggacaacaucaacacccccgagggcaucauccccgcccuguucgagcccgagagagagaagagcgccgccaucgacggcgagagcagacugagaggcgaggccagaaagaccuucguggagcugaugagaagaggcgaccugcccguguggcugagcuacaagguggccagcgagggcuuccaguacagcgacagaagauggugcuucgacggcgagagaaccaaccaggugcuggaggagaacauggccguggagaucuggcccaaggagggcgagagaaagaagcugagacccagaugccuggacgccagaaccuacagcgacccccuggcccugagagaguucaaggaguucccccccggcagaagaagcgugagcggcgaccugauccuggagaucggcaagcugccccacccccugacccagagaccccagaacgcccuggccacccuggugaugagccacaccagcgagcagggcggcagagccuacagacacgccauggaggagcugcccgccaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagcaacgccaccagacaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggccaagggcuggcccaucagcaagauggacaucggcgugccccugcuggcccugggcugcuacagccaggugaacccccugacccugaccgcccccgugcugaugcuggugccccacuaccccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugaccaagagcgaguucaacaccuacaagagaagcggcaucauggagguggacagaagcgaggccaaggagggccugaagagaggcgagaccaccaagcaccccgugagcagaggcaccgccaagcugagaugguucguggagagaacccuggugaagcccgagggcaaggugaucgaccugggcugcggcagaggcggcuggagcuacuacugcgccggccugaagaaggugaccgaggugaagggcuacaccaagggcggccccggccacgaggaccccauccccaugggcaccuacggcuggaaccuggugaagcugagaagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacauggccagcgugguggagacccuggagcagaugcagagaaagcacggcggcaugcuggugagaaacccccugagcagaaacagcacccacgagauguacugggugagcuggggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgagggcaagcccagcggcagcgccagcagcauggugaacggcggcgugaagcugcugaccaagcccugggacggcauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcggcggcaucuucagccccagagagcuggagacccccaaccuggccgagagagugcuggacuggguggagaaguacggcguggagagacuggagagaauggccaucagcggcgacgacugccugggcgagcccaucuacgacagauucgccaccgcccugaccgcccugaacgacaugggcaaggugagaaaggacaucccccagugggagcccagcaagggcuggaacgacuggcagcagggccccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauggacuuccacagaagagaccugagacuggccgccaacgccaucuggagcgccggccccggcgacuggauccccaccagaagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacauggccagcaugaagagauucaagaacgagagcgaccccgagggcgcccugugguga

SEQ ID NO: 16538 - RNA, 9879 nt, Artificial Sequence
  derived and/or modified CDS sequence (opt4) from DENV-1__KF921942__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgagguggccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16539 - RNA, 9879 nt, Artificial Sequence
  derived and/or modified CDS sequence (opt4) from DENV-1__JF937602__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucgugagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16540 - RNA, 9879 nt, Artificial Sequence
  derived and/or modified CDS sequence (opt4) from DENV-1__GU131729__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugggcaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggccccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgccagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaacccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgagggcaagcccagcggcagcgccagcagcaugggcaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16541 - RNA, 9879 nt, Artificial Sequence
  derived and/or modified CDS sequence (opt4) from DENV-1__GU131730__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugagagccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaccauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacaucuacaugggccagccccugaacaacgacgaggaccacgcccccuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16542 - RNA, 9879 nt, Artificial Sequence
  derived and/or modified CDS sequence (opt4) from DENV-1__GU131731__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaacccacaacaaggagggcgaccaguacaucagcaugggccagccccugaacaccgccgaggaccacgcccccuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggaccccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16543 - RNA, 9879 nt, Artificial Sequence
  derived and/or modified CDS sequence (opt4) from DENV-1__GU131733__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaacaucgacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16544 - RNA, 9879 nt, Artificial Sequence
  derived and/or modified CDS sequence (opt4) from DENV-1__GU131734__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccgacagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaucgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16545 - RNA, 9879 nt, Artificial Sequence
  derived and/or modified CDS sequence (opt4) from DENV-1__GU131738__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccggcagaagcuggaacagcggcuacgaguggaucaccgacuuccccggcaagaccgugugguucggccccaccaucaagagcggcaacgacaucgccaacugccugagaaagaacggcaagagagugauccagcugagcagaaagaccuucgacaccgaguaccagaagaccaagaacaacgacugggacuacgugggcaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccugggccagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16546 - RNA, 9879 nt, Artificial Sequence
  derived and/or modified CDS sequence (opt4) from DENV-1__JF937604__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaccuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcuucuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacgccgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagcagggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagccagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16547 - RNA, 9879 nt, Artificial Sequence
  derived and/or modified CDS sequence (opt4) from DENV-1__JF937605__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcacccugcaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccaacgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16548 - RNA, 9879 nt, Artificial Sequence
  derived and/or modified CDS sequence (opt4) from DENV-1__JF937608__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16549 - RNA, 9879 nt, Artificial Sequence
  derived and/or modified CDS sequence (opt4) from DENV-1__GU131739__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccccaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16550 - RNA, 9879 nt, Artificial Sequence
  derived and/or modified CDS sequence (opt4) from DENV-1__GU131740__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgugcccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagguguggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16551 - RNA, 9879 nt, Artificial Sequence
  derived and/or modified CDS sequence (opt4) from DENV-1__GU131741__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgugagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16552 - RNA, 9879 nt, Artificial Sequence
  derived and/or modified CDS sequence (opt4) from DENV-1__GU131743__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacgugaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16553 - RNA, 9879 nt, Artificial Sequence
  derived and/or modified CDS sequence (opt4) from DENV-1__JN093516__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccaccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16554 - RNA, 9879 nt, Artificial Sequence
  derived and/or modified CDS sequence (opt4) from DENV-1__GU131746__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16555 - RNA, 9879 nt, Artificial Sequence
  derived and/or modified CDS sequence (opt4) from DENV-1__JF937609__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16556 - RNA, 9879 nt, Artificial Sequence
  derived and/or modified CDS sequence (opt4) from DENV-1__KF921949__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucagaaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccaagaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16557 - RNA, 9879 nt, Artificial Sequence
  derived and/or modified CDS sequence (opt4) from DENV-1__GU131747__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccguguuccugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccgugcugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16558 - RNA, 9879 nt, Artificial Sequence
  derived and/or modified CDS sequence (opt4) from DENV-1__GU131748__SS-prME
agcgugaccaugcuguucaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcgugaagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16559 - RNA, 9879 nt, Artificial Sequence
  derived and/or modified CDS sequence (opt4) from DENV-1__GQ868615__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16560 - RNA, 9879 nt, Artificial Sequence
  derived and/or modified CDS sequence (opt4) from DENV-1__GU131749__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacagagugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16561 - RNA, 9879 nt, Artificial Sequence
  derived and/or modified CDS sequence (opt4) from DENV-1__GU131750__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagcaucgagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaugcagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaccauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16562 - RNA, 9879 nt, Artificial Sequence
  derived and/or modified CDS sequence (opt4) from DENV-1__GU131751__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaaggugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucagagacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcaaguggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacauccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccaccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16563 - RNA, 9879 nt, Artificial Sequence
  derived and/or modified CDS sequence (opt4) from DENV-1__GU131753__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucaucaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaugaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaccgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagaguguucgacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16564 - RNA, 9879 nt, Artificial Sequence
  derived and/or modified CDS sequence (opt4) from DENV-1__GU131754__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggacaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugcaugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16565 - RNA, 9879 nt, Artificial Sequence
  derived and/or modified CDS sequence (opt4) from DENV-1__GU131755__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16566 - RNA, 9879 nt, Artificial Sequence
  derived and/or modified CDS sequence (opt4) from DENV-1__GU131756__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgccuucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16567 - RNA, 9879 nt, Artificial Sequence
  derived and/or modified CDS sequence (opt4) from DENV-1__GU131758__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgugcccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagguguggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16568 - RNA, 9879 nt, Artificial Sequence
  derived and/or modified CDS sequence (opt4) from DENV-1__GU131759__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcuucaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagguguggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16569 - RNA, 9879 nt, Artificial Sequence
  derived and/or modified CDS sequence (opt4) from DENV-1__GU131761__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagauccaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16570 - RNA, 9879 nt, Artificial Sequence
  derived and/or modified CDS sequence (opt4) from DENV-1__GU131762__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaugagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguuccugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaguguacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16571 - RNA, 9879 nt, Artificial Sequence
  derived and/or modified CDS sequence (opt4) from DENV-1__GU131763__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggccugggcgagguggacagcuucagccugggccugcugugcaucagcaucaugaucgaggaggugaugagaagcagauggagcagaaagaugcugauggccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagagaugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacaagguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16572 - RNA, 9879 nt, Artificial Sequence
  derived and/or modified CDS sequence (opt4) from DENV-1__GU131766__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaucgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaucgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugcgccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16573 - RNA, 9879 nt, Artificial Sequence
  derived and/or modified CDS sequence (opt4) from DENV-1__GU131767__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugagagccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16574 - RNA, 9879 nt, Artificial Sequence
  derived and/or modified CDS sequence (opt4) from DENV-1__HM181967__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacauggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16575 - RNA, 9879 nt, Artificial Sequence
  derived and/or modified CDS sequence (opt4) from DENV-1__GU131768__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaacuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgccgacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16576 - RNA, 9879 nt, Artificial Sequence
  derived and/or modified CDS sequence (opt4) from DENV-1__GU131770__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16577 - RNA, 9879 nt, Artificial Sequence
  derived and/or modified CDS sequence (opt4) from DENV-1__GU131773__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcaugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuuccugcugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16578 - RNA, 9879 nt, Artificial Sequence
  derived and/or modified CDS sequence (opt4) from DENV-1__GU131775__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugguggugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcggcaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16579 - RNA, 9879 nt, Artificial Sequence
  derived and/or modified CDS sequence (opt4) from DENV-1__GU131777__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16580 - RNA, 9879 nt, Artificial Sequence
  derived and/or modified CDS sequence (opt4) from DENV-1__GU131778__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacauccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcagaauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16581 - RNA, 9879 nt, Artificial Sequence
  derived and/or modified CDS sequence (opt4) from DENV-1__GU131779__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggugagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16582 - RNA, 9879 nt, Artificial Sequence
  derived and/or modified CDS sequence (opt4) from DENV-1__GU131780__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucagcggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcugaccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagaccaugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16583 - RNA, 9879 nt, Artificial Sequence
  derived and/or modified CDS sequence (opt4) from DENV-1__GU131781__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggacaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugcaugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16584 - RNA, 9879 nt, Artificial Sequence
  derived and/or modified CDS sequence (opt4) from DENV-1__GU131782__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggccugggcgagguggacagcuucagccugggccugcugugcaucagcaucaugaucgaggaggugaugagaagcagauggagcagaaagaugcugauggccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagagaugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16585 - RNA, 9879 nt, Artificial Sequence
  derived and/or modified CDS sequence (opt4) from DENV-1__GU131784__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcaccacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccagaagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16586 - RNA, 9879 nt, Artificial Sequence
  derived and/or modified CDS sequence (opt4) from DENV-1__JF937612__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucagagacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16587 - RNA, 9879 nt, Artificial Sequence
  derived and/or modified CDS sequence (opt4) from DENV-1__GU131786__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggcccccgccagaggcgccagaagaauggccauccugggcgccaccgccugggacuucggcagcaucggcggcguguuccccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugagagccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16588 - RNA, 9879 nt, Artificial Sequence
  derived and/or modified CDS sequence (opt4) from DENV-1__GU131787__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16589 - RNA, 9879 nt, Artificial Sequence
  derived and/or modified CDS sequence (opt4) from DENV-1__HM181968__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucgccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcugcugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16590 - RNA, 9879 nt, Artificial Sequence
  derived and/or modified CDS sequence (opt4) from DENV-1__GU131789__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccauccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16591 - RNA, 9879 nt, Artificial Sequence
  derived and/or modified CDS sequence (opt4) from DENV-1__GU131790__SS-prME
agcgugaccaugcugcugaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagcugaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcgugaagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16592 - RNA, 9879 nt, Artificial Sequence
  derived and/or modified CDS sequence (opt4) from DENV-1__GU131791__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggccccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugauccugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16593 - RNA, 9879 nt, Artificial Sequence
  derived and/or modified CDS sequence (opt4) from DENV-1__GU131792__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagcccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagccuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaccuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugcccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccggccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucggcaccaacgaggugcacaccuggaccgagcaguacaaguuccaggccgacagccccaagagacugagcgccgccaucggcaagcccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugauggccgccgccaucaaggacagaaaggccgugcacgccgacaugggcuacuggaucgagagcgagaagaacgagcccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcuggccagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16594 - RNA, 9879 nt, Artificial Sequence
  derived and/or modified CDS sequence (opt4) from DENV-1__HM488256__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugcccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgcccccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucugggccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagccccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugcccuggaacgaccugaucagacugugcaucauggugggcgccaccgccagcgccagaaugggcaugggcaccaccagccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugggccugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16595 - RNA, 9879 nt, Artificial Sequence
  derived and/or modified CDS sequence (opt4) from DENV-1__GU131793__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaccacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16596 - RNA, 9879 nt, Artificial Sequence
  derived and/or modified CDS sequence (opt4) from DENV-1__GU131794__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16597 - RNA, 9879 nt, Artificial Sequence
  derived and/or modified CDS sequence (opt4) from DENV-1__GU131796__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcguggaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccagcagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16598 - RNA, 9879 nt, Artificial Sequence
  derived and/or modified CDS sequence (opt4) from DENV-1__GU131797__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16599 - RNA, 9879 nt, Artificial Sequence
  derived and/or modified CDS sequence (opt4) from DENV-1__GU131801__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucggcaucggcgccggcgagaaggcccugaagcugagcugggugaagaagggcagcagcaucggcaagaugguggaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16600 - RNA, 9879 nt, Artificial Sequence
  derived and/or modified CDS sequence (opt4) from DENV-1__GU131804__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaacaucgacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16601 - RNA, 9879 nt, Artificial Sequence
  derived and/or modified CDS sequence (opt4) from DENV-1__GU131805__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagccccgagauccagcugcccgacuacggcgcccugacccuggacugcagccccagacccggccuggacuucaacgagauggugcugcugcccaugaaggagaagagcuggcuggugcacaagcagugguuccuggaccugccccugcccuggaccagcggcgccagcaccagccaggagaccuggaacagaaaggaccugcugggcaccuucaagaccgcccacgccaaggagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagcccgccuucggcgagagcuacaucgugaucggcgccggcgagaaggcccugaagcugagcugggugaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucggcaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgccaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagcccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugcccggcaagaucauccacgaguggugcugcagaagcugcacccugcccccccugagauucaagggcgaggacggcugcugguacggcauggagaucagccccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcccccugcccguguucuuccugcugaucaugggccagcugcccuggaacgaccugaucagacugugcaucauggugggcgccaacgccagcgacagaaugggcaugggcacccccuaccuggcccugauggccaccuucaagaugagacccauguucgccgugggccugcuguucagaagacugaccagcagagagggccugcugcugaccaucggccugagccugguggccagcguggagcugcccaacagccuggaggagcugggcgacggccuggccaugggcaucaugauccugaagcugcugaccgacuuccagagccaccagcugugggccacccugcuggcccugaccuucaucaagaccaccuucagccuggacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcggcagccacaacauccugguggaggugcaggacgacggcaccaugaagaucaaggacgaggagagagacgccacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16602 - RNA, 9879 nt, Artificial Sequence
  derived and/or modified CDS sequence (opt4) from DENV-1__GU131806__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccuggccuggaccagcggcggcagcaccagccaggagaccuggaacagacaggaccugguggugaccuucaagaccgcccacggcaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccuggccaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggccccagccacaacauccugguggaggugcaggacgacggccccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagauccugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16603 - RNA, 9879 nt, Artificial Sequence
  derived and/or modified CDS sequence (opt4) from DENV-1__GU131807__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagcccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcuggugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggccccgccuacggcgugcuguucagcggcgugagcuggcccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgaccacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaucagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagaagaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16604 - RNA, 9879 nt, Artificial Sequence
  derived and/or modified CDS sequence (opt4) from DENV-1__GU131811__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaucggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgagaccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagguggugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16605 - RNA, 9882 nt, Artificial Sequence
  derived and/or modified CDS sequence (opt4) from DENV-1__JF937615__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccgaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccgacagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaucgacuuccagagccaccagcugugggccacccugcugagccugaccuucaucaagaccaccuucagccugcacuacgccuggaagaccauggccauggugcugagcaucgugagccuguucccccugcugcccgugcacgaccugcccaagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcgcccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugauguuccuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16606 - RNA, 9879 nt, Artificial Sequence
  derived and/or modified CDS sequence (opt4) from DENV-1__GU131814__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacgagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16607 - RNA, 9879 nt, Artificial Sequence
  derived and/or modified CDS sequence (opt4) from DENV-1__GU131815__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccagacuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaccaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgccagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcguggccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16608 - RNA, 9879 nt, Artificial Sequence
  derived and/or modified CDS sequence (opt4) from DENV-1__GU131818__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcuggugcugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccagccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugaaggagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16609 - RNA, 9879 nt, Artificial Sequence
  derived and/or modified CDS sequence (opt4) from DENV-1__GU131820__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggccugggcgagguggacagcuucagccugggccugcugugcaucagcaucaugaucgaggaggugaugagaagcagauggagcagaaagaugcugauggccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagagaugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16610 - RNA, 9879 nt, Artificial Sequence
  derived and/or modified CDS sequence (opt4) from DENV-1__HM181970__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccuucgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggaggacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16611 - RNA, 9879 nt, Artificial Sequence
  derived and/or modified CDS sequence (opt4) from DENV-1__GU131821__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcagcacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16612 - RNA, 9879 nt, Artificial Sequence
  derived and/or modified CDS sequence (opt4) from DENV-1__JF937617__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaugggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgagaucggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16613 - RNA, 9879 nt, Artificial Sequence
  derived and/or modified CDS sequence (opt4) from DENV-1__JF937618__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccagaaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggaccgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16614 - RNA, 9879 nt, Artificial Sequence
  derived and/or modified CDS sequence (opt4) from DENV-1__JF937619__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggugaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaagaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugaucuacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16615 - RNA, 9879 nt, Artificial Sequence
  derived and/or modified CDS sequence (opt4) from DENV-1__GU131827__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucagaaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgccaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucgugcccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16616 - RNA, 9879 nt, Artificial Sequence
  derived and/or modified CDS sequence (opt4) from DENV-1__GU131831__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16617 - RNA, 9879 nt, Artificial Sequence
  derived and/or modified CDS sequence (opt4) from DENV-1__EU482789__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagauggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcagaggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16618 - RNA, 9879 nt, Artificial Sequence
  derived and/or modified CDS sequence (opt4) from DENV-1__EU482790__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcagcagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgugcccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugcccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16619 - RNA, 9879 nt, Artificial Sequence
  derived and/or modified CDS sequence (opt4) from DENV-1__EU482791__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16620 - RNA, 9879 nt, Artificial Sequence
  derived and/or modified CDS sequence (opt4) from DENV-1__EU482792__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16621 - RNA, 9879 nt, Artificial Sequence
  derived and/or modified CDS sequence (opt4) from DENV-1__EU482707__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16622 - RNA, 9879 nt, Artificial Sequence
  derived and/or modified CDS sequence (opt4) from DENV-1__EU482708__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucagcgagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16623 - RNA, 9879 nt, Artificial Sequence
  derived and/or modified CDS sequence (opt4) from DENV-1__EU482709__SS-prME
agcgugaccaugcugcugaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16624 - RNA, 9879 nt, Artificial Sequence
  derived and/or modified CDS sequence (opt4) from DENV-1__EU482710__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaagcacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucagcgagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucaucgccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16625 - RNA, 9879 nt, Artificial Sequence
  derived and/or modified CDS sequence (opt4) from DENV-1__EU482712__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaacuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccgugcuguuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16626 - RNA, 9879 nt, Artificial Sequence
  derived and/or modified CDS sequence (opt4) from DENV-1__EU249490__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaagaaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16627 - RNA, 9879 nt, Artificial Sequence
  derived and/or modified CDS sequence (opt4) from DENV-1__EU249491__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16628 - RNA, 9879 nt, Artificial Sequence
  derived and/or modified CDS sequence (opt4) from DENV-1__EU249492__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugcagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcagcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggacacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcggccccgagggcgcccugugguga

SEQ ID NO: 16629 - RNA, 9879 nt, Artificial Sequence
  derived and/or modified CDS sequence (opt4) from DENV-1__EU249493__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagacaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16630 - RNA, 9879 nt, Artificial Sequence
  derived and/or modified CDS sequence (opt4) from DENV-1__EU249494__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacugcaugaccagcaugaagagauucaagaacgagggcgaccccgagggcgcccugugguga

SEQ ID NO: 16631 - RNA, 9879 nt, Artificial Sequence
  derived and/or modified CDS sequence (opt4) from DENV-1__EU249495__SS-prME
agcgugaccaugcugcugaugcugaugcccaccgcccuggccuuccaccugaccaccagaggcggcgagccccacaugaucgugaccaagcaggagagaggcaagagccugcuguucaagaccaccgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16632 - RNA, 9879 nt, Artificial Sequence
  derived and/or modified CDS sequence (opt4) from DENV-1__EU482794__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgccagccuguucccccugugccugagcaccaccagccagaagaccaccuggcugcccgugcugcugggcagccugggcugcaagccccugaccauguuccugaucaccgagaccaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccuggugguggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaacuacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16633 - RNA, 9879 nt, Artificial Sequence
  derived and/or modified CDS sequence (opt4) from DENV-1__EU482795__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucagcggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaagaaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16634 - RNA, 9879 nt, Artificial Sequence
  derived and/or modified CDS sequence (opt4) from DENV-1__EU482796__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16635 - RNA, 9879 nt, Artificial Sequence
  derived and/or modified CDS sequence (opt4) from DENV-1__EU482797__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16636 - RNA, 9879 nt, Artificial Sequence
  derived and/or modified CDS sequence (opt4) from DENV-1__EU482799__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgagauccacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16637 - RNA, 9879 nt, Artificial Sequence
  derived and/or modified CDS sequence (opt4) from DENV-1__EU482800__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggccagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaucgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagaguguucgacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16638 - RNA, 9879 nt, Artificial Sequence
  derived and/or modified CDS sequence (opt4) from DENV-1__EU482801__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16639 - RNA, 9879 nt, Artificial Sequence
  derived and/or modified CDS sequence (opt4) from DENV-1__EU482802__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaagaaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaagagcaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16640 - RNA, 9879 nt, Artificial Sequence
  derived and/or modified CDS sequence (opt4) from DENV-1__EU482804__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagguggugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaccggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16641 - RNA, 9879 nt, Artificial Sequence
  derived and/or modified CDS sequence (opt4) from DENV-1__EU482806__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccugcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16642 - RNA, 9879 nt, Artificial Sequence
  derived and/or modified CDS sequence (opt4) from DENV-1__EU482807__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugguggccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16643 - RNA, 9879 nt, Artificial Sequence
  derived and/or modified CDS sequence (opt4) from DENV-1__EU482808__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagagacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16644 - RNA, 9879 nt, Artificial Sequence
  derived and/or modified CDS sequence (opt4) from DENV-1__EU482809__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16645 - RNA, 9879 nt, Artificial Sequence
  derived and/or modified CDS sequence (opt4) from DENV-1__EU482810__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugcagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcagcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggacacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcggccccgagggcgcccugugguga

SEQ ID NO: 16646 - RNA, 9879 nt, Artificial Sequence
  derived and/or modified CDS sequence (opt4) from DENV-1__EU482811__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccggcagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16647 - RNA, 9879 nt, Artificial Sequence
  derived and/or modified CDS sequence (opt4) from DENV-1__EU482812__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16648 - RNA, 9879 nt, Artificial Sequence
  derived and/or modified CDS sequence (opt4) from DENV-1__EU482813__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgaggaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16649 - RNA, 9879 nt, Artificial Sequence
  derived and/or modified CDS sequence (opt4) from DENV-1__EU482814__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggcuucggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16650 - RNA, 9879 nt, Artificial Sequence
  derived and/or modified CDS sequence (opt4) from DENV-1__EU482815__SS-prME
agcgugaccaugcugcugaugcugaugcccgccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaccgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguucuucaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16651 - RNA, 9879 nt, Artificial Sequence
  derived and/or modified CDS sequence (opt4) from DENV-1__EU482816__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16652 - RNA, 9879 nt, Artificial Sequence
  derived and/or modified CDS sequence (opt4) from DENV-1__EU482821__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16653 - RNA, 9879 nt, Artificial Sequence
  derived and/or modified CDS sequence (opt4) from DENV-1__EU482822__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacagcauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16654 - RNA, 9879 nt, Artificial Sequence
  derived and/or modified CDS sequence (opt4) from DENV-1__EU482476__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccuggccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16655 - RNA, 9879 nt, Artificial Sequence
  derived and/or modified CDS sequence (opt4) from DENV-1__EU482477__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccaugcuggccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuacagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16656 - RNA, 9879 nt, Artificial Sequence
  derived and/or modified CDS sequence (opt4) from DENV-1__EU482478__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16657 - RNA, 9879 nt, Artificial Sequence
  derived and/or modified CDS sequence (opt4) from DENV-1__EU482479__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaucugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugguggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16658 - RNA, 9879 nt, Artificial Sequence
  derived and/or modified CDS sequence (opt4) from DENV-1__EU482480__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcacccagaucggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggccacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16659 - RNA, 9879 nt, Artificial Sequence
  derived and/or modified CDS sequence (opt4) from DENV-1__EU482481__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucagcgagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucaucgccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16660 - RNA, 9879 nt, Artificial Sequence
  derived and/or modified CDS sequence (opt4) from DENV-1__EU482482__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16661 - RNA, 9879 nt, Artificial Sequence
  derived and/or modified CDS sequence (opt4) from DENV-1__EU482485__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccaccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccguggacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16662 - RNA, 9879 nt, Artificial Sequence
  derived and/or modified CDS sequence (opt4) from DENV-1__EU482486__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgacagcgaccccgagggcgcccugugguga

SEQ ID NO: 16663 - RNA, 9879 nt, Artificial Sequence
  derived and/or modified CDS sequence (opt4) from DENV-1__EU482487__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgccaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16664 - RNA, 9879 nt, Artificial Sequence
  derived and/or modified CDS sequence (opt4) from DENV-1__EU482488__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16665 - RNA, 9879 nt, Artificial Sequence
  derived and/or modified CDS sequence (opt4) from DENV-1__EU482489__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucacccugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16666 - RNA, 9879 nt, Artificial Sequence
  derived and/or modified CDS sequence (opt4) from DENV-1__EU482490__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaccaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16667 - RNA, 9879 nt, Artificial Sequence
  derived and/or modified CDS sequence (opt4) from DENV-1__EU482491__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcacccagaucggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggccacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagaucuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16668 - RNA, 9879 nt, Artificial Sequence
  derived and/or modified CDS sequence (opt4) from DENV-1__EU482493__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16669 - RNA, 9879 nt, Artificial Sequence
  derived and/or modified CDS sequence (opt4) from DENV-1__EU482494__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaucaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggccacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugagaggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16670 - RNA, 9879 nt, Artificial Sequence
  derived and/or modified CDS sequence (opt4) from DENV-1__EU482495__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccagaaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugagcgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgacagcgaccccgagggcgcccugugguga

SEQ ID NO: 16671 - RNA, 9879 nt, Artificial Sequence
  derived and/or modified CDS sequence (opt4) from DENV-1__EU482496__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16672 - RNA, 9879 nt, Artificial Sequence
  derived and/or modified CDS sequence (opt4) from DENV-1__EU482497__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccagggcaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaccauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16673 - RNA, 9879 nt, Artificial Sequence
  derived and/or modified CDS sequence (opt4) from DENV-1__EU482499__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugaagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16674 - RNA, 9879 nt, Artificial Sequence
  derived and/or modified CDS sequence (opt4) from DENV-1__EU482500__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggaggccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16675 - RNA, 9879 nt, Artificial Sequence
  derived and/or modified CDS sequence (opt4) from DENV-1__EU482501__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16676 - RNA, 9879 nt, Artificial Sequence
  derived and/or modified CDS sequence (opt4) from DENV-1__EU482504__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggugacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaucagcgagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16677 - RNA, 9879 nt, Artificial Sequence
  derived and/or modified CDS sequence (opt4) from DENV-1__EU482505__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaaggccuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucaacagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaucgaccccgagggcgcccugugguga

SEQ ID NO: 16678 - RNA, 9879 nt, Artificial Sequence
  derived and/or modified CDS sequence (opt4) from DENV-1__EU482506__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16679 - RNA, 9879 nt, Artificial Sequence
  derived and/or modified CDS sequence (opt4) from DENV-1__EU482509__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucgugcccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgagcccgagggcgcccugugguga

SEQ ID NO: 16680 - RNA, 9879 nt, Artificial Sequence
  derived and/or modified CDS sequence (opt4) from DENV-1__EU482510__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugagaaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggaucgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16681 - RNA, 9879 nt, Artificial Sequence
  derived and/or modified CDS sequence (opt4) from DENV-1__EU482511__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaugagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16682 - RNA, 9879 nt, Artificial Sequence
  derived and/or modified CDS sequence (opt4) from DENV-1__EU482513__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16683 - RNA, 9879 nt, Artificial Sequence
  derived and/or modified CDS sequence (opt4) from DENV-1__EU482515__SS-prME
agcgugaccacccugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaugagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcaagaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16684 - RNA, 9879 nt, Artificial Sequence
  derived and/or modified CDS sequence (opt4) from DENV-1__EU482516__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16685 - RNA, 9879 nt, Artificial Sequence
  derived and/or modified CDS sequence (opt4) from DENV-1__EU482517__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaacaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggacagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16686 - RNA, 9879 nt, Artificial Sequence
  derived and/or modified CDS sequence (opt4) from DENV-1__EU482519__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagguggugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16687 - RNA, 9879 nt, Artificial Sequence
  derived and/or modified CDS sequence (opt4) from DENV-1__EU482520__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugagagagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacggccacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcauccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16688 - RNA, 9879 nt, Artificial Sequence
  derived and/or modified CDS sequence (opt4) from DENV-1__EU482521__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcagaauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacaucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16689 - RNA, 9879 nt, Artificial Sequence
  derived and/or modified CDS sequence (opt4) from DENV-1__EU482523__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccaggccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaagaaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16690 - RNA, 9879 nt, Artificial Sequence
  derived and/or modified CDS sequence (opt4) from DENV-1__EU482525__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccugggccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugagaggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaccgaccccgagggcgcccugugguga

SEQ ID NO: 16691 - RNA, 9879 nt, Artificial Sequence
  derived and/or modified CDS sequence (opt4) from DENV-1__EU482526__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagauccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacgugccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16692 - RNA, 9879 nt, Artificial Sequence
  derived and/or modified CDS sequence (opt4) from DENV-1__EU482527__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccuucguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16693 - RNA, 9879 nt, Artificial Sequence
  derived and/or modified CDS sequence (opt4) from DENV-1__EU482528__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaagcacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagaggcaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16694 - RNA, 9879 nt, Artificial Sequence
  derived and/or modified CDS sequence (opt4) from DENV-1__EU482529__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcacccugcaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagggcgaccccgagggcgcccugugguga

SEQ ID NO: 16695 - RNA, 9879 nt, Artificial Sequence
  derived and/or modified CDS sequence (opt4) from DENV-1__EU482531__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccaacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16696 - RNA, 9879 nt, Artificial Sequence
  derived and/or modified CDS sequence (opt4) from DENV-1__EU482532__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagaagcggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16697 - RNA, 9879 nt, Artificial Sequence
  derived and/or modified CDS sequence (opt4) from DENV-1__EU482533__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaccgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugaucgugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16698 - RNA, 9879 nt, Artificial Sequence
  derived and/or modified CDS sequence (opt4) from DENV-1__EU482534__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucgugagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16699 - RNA, 9879 nt, Artificial Sequence
  derived and/or modified CDS sequence (opt4) from DENV-1__EU482535__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagaugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccagaaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacaucgacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgugcagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugaagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16700 - RNA, 9879 nt, Artificial Sequence
  derived and/or modified CDS sequence (opt4) from DENV-1__EU482536__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacaugcugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16701 - RNA, 9879 nt, Artificial Sequence
  derived and/or modified CDS sequence (opt4) from DENV-1__EU482537__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugauccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 16702 - RNA, 9879 nt, Artificial Sequence
  derived and/or modified CDS sequence (opt4) from DENV-1__EU482538__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacagagagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccuggagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggacagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16703 - RNA, 9879 nt, Artificial Sequence
  derived and/or modified CDS sequence (opt4) from DENV-1__EU482539__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcacccugcagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaacauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16704 - RNA, 9879 nt, Artificial Sequence
  derived and/or modified CDS sequence (opt4) from DENV-1__KP188539__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaaggacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaccaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16705 - RNA, 9879 nt, Artificial Sequence
  derived and/or modified CDS sequence (opt4) from DENV-1__KP188540__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcaugcugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgccacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16706 - RNA, 9879 nt, Artificial Sequence
  derived and/or modified CDS sequence (opt4) from DENV-1__KP188541__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguucuucaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgagaacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccguggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16707 - RNA, 9879 nt, Artificial Sequence
  derived and/or modified CDS sequence (opt4) from DENV-1__KP188543__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugguggaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16708 - RNA, 9879 nt, Artificial Sequence
  derived and/or modified CDS sequence (opt4) from DENV-1__KP188544__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccugcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugaugcaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcaccacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16709 - RNA, 9879 nt, Artificial Sequence
  derived and/or modified CDS sequence (opt4) from DENV-1__KP188547__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucaagccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgcccuggacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccagcagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcacccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16710 - RNA, 9879 nt, Artificial Sequence
  derived and/or modified CDS sequence (opt4) from DENV-1__KP723473__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagugcgacagcagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcauccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcaccgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16711 - RNA, 9879 nt, Artificial Sequence
  derived and/or modified CDS sequence (opt4) from DENV-1__KT187564__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguucccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagaagacugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16712 - RNA, 9879 nt, Artificial Sequence
  derived and/or modified CDS sequence (opt4) from DENV-1__KT187560__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16713 - RNA, 9879 nt, Artificial Sequence
  derived and/or modified CDS sequence (opt4) from DENV-1__KT187561__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguuccugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16714 - RNA, 9879 nt, Artificial Sequence
  derived and/or modified CDS sequence (opt4) from DENV-1__KT187562__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16715 - RNA, 9879 nt, Artificial Sequence
  derived and/or modified CDS sequence (opt4) from DENV-1__JQ045628__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccuggagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaucgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16716 - RNA, 9879 nt, Artificial Sequence
  derived and/or modified CDS sequence (opt4) from DENV-1__JQ045629__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16717 - RNA, 9879 nt, Artificial Sequence
  derived and/or modified CDS sequence (opt4) from DENV-1__JQ045630__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaucgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16718 - RNA, 9879 nt, Artificial Sequence
  derived and/or modified CDS sequence (opt4) from DENV-1__JQ045632__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaucggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugaagaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugauccugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16719 - RNA, 9879 nt, Artificial Sequence
  derived and/or modified CDS sequence (opt4) from DENV-1__JQ045633__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcuggccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccagaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggugagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaguacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16720 - RNA, 9879 nt, Artificial Sequence
  derived and/or modified CDS sequence (opt4) from DENV-1__JQ045634__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcuggccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccagaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggugagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaguacgccgugagcagaggcaccgccaagcugagaugguucguggagagaaaccuggugaagcccgagggcaaggugaucgaccugggcugcggcagaggcggcugggccuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16721 - RNA, 9879 nt, Artificial Sequence
  derived and/or modified CDS sequence (opt4) from DENV-1__JQ045636__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccgacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgaccccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16722 - RNA, 9879 nt, Artificial Sequence
  derived and/or modified CDS sequence (opt4) from DENV-1__JQ045635__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaucgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccgacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucagaaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgaccccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcugggccuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugcugggcaacgagaacuaccuggacuacaugaccagcaugaagagauucaagaacgagagcgaccccgagggcgcccugugguga

SEQ ID NO: 16723 - RNA, 9879 nt, Artificial Sequence
  derived and/or modified CDS sequence (opt4) from DENV-1__JQ045637__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagccugagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccgccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccaucgaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16724 - RNA, 9879 nt, Artificial Sequence
  derived and/or modified CDS sequence (opt4) from DENV-1__JQ045638__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagccugagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccgccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccaucgaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcugggccuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16725 - RNA, 9879 nt, Artificial Sequence
  derived and/or modified CDS sequence (opt4) from DENV-1__JQ045639__SS-prME
agcgugaccauguuccugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcagaugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16726 - RNA, 9879 nt, Artificial Sequence
  derived and/or modified CDS sequence (opt4) from DENV-1__JQ045641__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcguggcccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacaccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16727 - RNA, 9879 nt, Artificial Sequence
  derived and/or modified CDS sequence (opt4) from DENV-1__JQ045642__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcagugcgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16728 - RNA, 9879 nt, Artificial Sequence
  derived and/or modified CDS sequence (opt4) from DENV-1__JQ045644__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccgccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccagaagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16729 - RNA, 9879 nt, Artificial Sequence
  derived and/or modified CDS sequence (opt4) from DENV-1__JQ045648__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcguggcccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacaccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccaccugcaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16730 - RNA, 9879 nt, Artificial Sequence
  derived and/or modified CDS sequence (opt4) from DENV-1__JQ045649__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugagagagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccagccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugaagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcugcacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16731 - RNA, 9879 nt, Artificial Sequence
  derived and/or modified CDS sequence (opt4) from DENV-1__JQ045650__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugagagagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccagccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcugggccuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugaagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcugcacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16732 - RNA, 9879 nt, Artificial Sequence
  derived and/or modified CDS sequence (opt4) from DENV-1__JQ045651__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaguacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16733 - RNA, 9879 nt, Artificial Sequence
  derived and/or modified CDS sequence (opt4) from DENV-1__JQ045652__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaguacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16734 - RNA, 9879 nt, Artificial Sequence
  derived and/or modified CDS sequence (opt4) from DENV-1__JQ045653__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcaagaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacugcgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggaggacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16735 - RNA, 9879 nt, Artificial Sequence
  derived and/or modified CDS sequence (opt4) from DENV-1__JQ045657__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16736 - RNA, 9879 nt, Artificial Sequence
  derived and/or modified CDS sequence (opt4) from DENV-1__JQ045659__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggccguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcauggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagaaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagagacccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16737 - RNA, 9879 nt, Artificial Sequence
  derived and/or modified CDS sequence (opt4) from DENV-1__JQ045661__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucaugaucggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcguggugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaaguacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16738 - RNA, 9879 nt, Artificial Sequence
  derived and/or modified CDS sequence (opt4) from DENV-1__JQ045663__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccagcacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaacagcaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguuccugcugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16739 - RNA, 9879 nt, Artificial Sequence
  derived and/or modified CDS sequence (opt4) from DENV-1__JQ045665__SS-prME
agcgugaccaugcugcugaugcugaugcccaccgcccuggccuuccaccugaccgccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccgugguggugaacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagacugagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcaccacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagagcuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccaccugcaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16740 - RNA, 9879 nt, Artificial Sequence
  derived and/or modified CDS sequence (opt4) from DENV-1__JQ045666__SS-prME
agcgugaccaugcugcugaugcugaugcccaccgcccuggccuuccaccugaccgccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagcuggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccgugguggugaacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagacugagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcaccacgccuggaagaccauggccaugauccugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagagcuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16741 - RNA, 9879 nt, Artificial Sequence
  derived and/or modified CDS sequence (opt4) from DENV-1__JQ045667__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccaacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugauggccugcuacgugaucagcggcagcagcgccgaccugagccuggagaaggccgccgaggugagcugggaggaggaggccgagcacagcggcgccagccacaacauccugguggaggugcagggcgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgaggugggcagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccauccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16742 - RNA, 9879 nt, Artificial Sequence
  derived and/or modified CDS sequence (opt4) from DENV-1__KU094071__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccaaggccgagcccgacgacguggacugcuggugcaacgccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcggcaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaagagaaagagcuggcuggugcacaagcagugguuccuggaccugccccugcccuggaccagcggcgccagcaccccccaggagaccuggaacagagaggaccugcuggugaccuucaagaccgcccacgccaagaagcaggaggugguggugcugggcagccaggagggcgccaugcacaccgcccugaccggcgccaccgagauccagaccagcggcaccaccaagaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagaugcuggaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguucagagccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccugacccagggcagaaagaugaucggcccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccccagacugaugagcgccgccaucaaggacagcaaggccgugcacgccgacaugggcuacuggaucgagagcgagaagaacgagaccuggagacuggccagagccagcuucaucgaggugaagaccugcguguggcccaagagccacacccuguggagcaacggcgugcuggagagcgagaugaucauccccaagaucuacggcggccccaucagccagcacaacuacagacccggcuacagcacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggacaaggaggagaaccuggugaagagccuggugagcgccggcagcggcgagguggacagcuucagccugggccugcugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaucgccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccgcccugcugagccugaccuucaucaagaccaccuucagccugcacuacgccuggaagaccauggccauggugcugagcaccgugagccuguucccccugugccugagcaccaccagcagaaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaucagcauccccgccacccuguucgugugguacuucagacagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgugaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugcagcaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagaggcaagagcgccgccaucgacggcgaguacagacugagaggcgaggccagaaagaccuucguggagcugaugagaagaggcgaccugcccguguggcugagcuacaagguggccagcgagggcuuccaguacagcgacagaaaguggugcuucgacggcgagagaaacaaccaggugcuggaggagaacauggacguggagaucuggaccaaggagggcgagagaaagaagcugagacccagauggcuggacgccagaaccuacagcgacccccaggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggguggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccccacccugaucgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugagcaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucccccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaaggacgagagcgaccuggagggcgcccugugguga

SEQ ID NO: 16743 - RNA, 9879 nt, Artificial Sequence
  derived and/or modified CDS sequence (opt4) from DENV-1__HQ624983__SS-prME
agcgugaccaugcugcugaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccaccugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaacagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccgccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16744 - RNA, 9879 nt, Artificial Sequence
  derived and/or modified CDS sequence (opt4) from DENV-1__FJ384655__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacuggccagcagagaggugcugcugcugaccaucggccugagccugguggccagcguggagcugcccaacagccuggaggagcugggcgacggccuggccaugggcaucaugaugcugaagcugcugaccgaguuccagccccaccaccuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcgccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagggcgccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugagcagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcggcuacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16745 - RNA, 9879 nt, Artificial Sequence
  derived and/or modified CDS sequence (opt4) from DENV-1__KC759167__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcgugacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggcccccgagguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccaagccccccuucggcgagagcugcaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcaccccccccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcgcccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggagaaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgagggcgugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgaguacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuacguggagcugaugagaagaggcgaccugcccguguggcugagcuacaagguggccagcgagggcuuccaguacagcgacagaagaugguacuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcuggaguucaacagcuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcagcagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagugcuggacuggcuggagaaguacggcaucgagagacugaagagaauggccaucagcggcgacgacugcguggugaagcccaucgacaacagauucgccaccgcccugaccgcccugaacgacaugggcaaggugagaaaggacaucccccagugggagcccagcaagggcuggaacgacuggcagcaggugccccugugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16746 - RNA, 9879 nt, Artificial Sequence
  derived and/or modified CDS sequence (opt4) from DENV-1__JQ048541__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaagcugagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggggccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16747 - RNA, 9879 nt, Artificial Sequence
  derived and/or modified CDS sequence (opt4) from DENV-1__JN697056__SS-prME
agcgugaccaugcugcugaugcugcugcccaccgcccugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacaucggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggccccuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcaugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagagcaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcaagaagaugcugaugaccggcacccuggccguguuccugcugcugaccaugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagagccaccagcugugggccacccugcugagccugaccuucgugaagaccaccuucagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucgugugguacuucuggcagaagagaaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccuggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucguggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgcccagcugaucagacagauggagagcgagggcaucuuccugcccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16748 - RNA, 9879 nt, Artificial Sequence
  derived and/or modified CDS sequence (opt4) from DENV-1__JN697057__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaucugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaaggugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggugacccugcugagccugaccuucaucaagaccgccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagagaaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcuggccgcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugguggaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccaagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16749 - RNA, 9879 nt, Artificial Sequence
  derived and/or modified CDS sequence (opt4) from DENV-1__HQ624984__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgcccugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaccgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16750 - RNA, 9879 nt, Artificial Sequence
  derived and/or modified CDS sequence (opt4) from DENV-1__HQ891314__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaccgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16751 - RNA, 9879 nt, Artificial Sequence
  derived and/or modified CDS sequence (opt4) from DENV-1__HQ891315__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcaucgugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16752 - RNA, 9879 nt, Artificial Sequence
  derived and/or modified CDS sequence (opt4) from DENV-1__HQ891316__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16753 - RNA, 9879 nt, Artificial Sequence
  derived and/or modified CDS sequence (opt4) from DENV-1__JN054256__SS-prME
agcgugaccaugcugcugaugcugaugcccaccgcccuggccuuccaccugaccaccagagagggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaccgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaucgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16754 - RNA, 9879 nt, Artificial Sequence
  derived and/or modified CDS sequence (opt4) from DENV-1__JN054255__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagaaggccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcggcaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgagaaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcauggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccagcaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccaagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16755 - RNA, 9879 nt, Artificial Sequence
  derived and/or modified CDS sequence (opt4) from DENV-1__KP406801__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacaccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccuggccggcgccaccgagauccagaugagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcauccaggacgagaagggcgugacccagaacggcagacugaucaccgccaaccccaucgccaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugagacccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagaaguucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16756 - RNA, 9879 nt, Artificial Sequence
  derived and/or modified CDS sequence (opt4) from DENV-1__KP406802__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaucuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16757 - RNA, 9879 nt, Artificial Sequence
  derived and/or modified CDS sequence (opt4) from DENV-1__KP406803__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaaggugaucggcgccgacgugcagaacaucaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcugaccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcauccccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugagaaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga
